United States Patent 12,569,549 (FLAVIVIRUS VACCINE) - sequence listing, part 43

SEQ ID NO: 15955 - RNA, 9879 nt, synthetic construct
  misc_feature 1..9879: note = derived and/or modified CDS sequence (opt4) from DENV-1__HM181959__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagagcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaaggtgatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15956 - RNA, 9879 nt, synthetic construct
  misc_feature 1..9879: note = derived and/or modified CDS sequence (opt4) from DENV-1__JF937651__SS-prME
  source 1..9879: mol_type = other RNA
agcgtgaccatgctgctgatgctgatgcccaccgccctggccttccacctgaccaccagaggcggcgagccccacatgatcctgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgcctgcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtgggcaaccaccaccacgccgccatgctggacgtggacctgcaccccgccagcgcctggaccctgtacgccgtggccaccaccatcatcacccccatgatgaagcacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccggcaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccaagggcgccctgtggtga

SEQ ID NO: 15957 - RNA, 9879 nt, synthetic construct
  misc_feature 1..9879: note = derived and/or modified CDS sequence (opt4) from DENV-1__GU131956__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcaccatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15958 - RNA, 9879 nt, synthetic construct
  misc_feature 1..9879: note = derived and/or modified CDS sequence (opt4) from DENV-1__GU131958__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15959 - RNA, 9879 nt, synthetic construct
  misc_feature 1..9879: note = derived and/or modified CDS sequence (opt4) from DENV-1__GQ868499__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcggccacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaaggacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcctggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggtggccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15960 - RNA, 9879 nt, synthetic construct
  misc_feature 1..9879: note = derived and/or modified CDS sequence (opt4) from DENV-1__GQ868500__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcgtgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgaagcagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtgggcgagaaccagtggaacagcgccaaggaggccgtggaggacgagagagtgtgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15961 - RNA, 9879 nt, synthetic construct
  misc_feature 1..9879: note = derived and/or modified CDS sequence (opt4) from DENV-1__GU131961__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcagactggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgtgctgtggtga

SEQ ID NO: 15962 - RNA, 9870 nt, synthetic construct
  misc_feature 1..9870: note = derived and/or modified CDS sequence (opt4) from DENV-1__GU131962__SS-prME
  source 1..9870: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgagtacgccagcgccggcctggccatcatcgtgcccctgcccctggacacctacggcagaaacagactgaagatccacagcggcaaggacgtgttcttcatgccccccgagaagggcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15963 - RNA, 9879 nt, synthetic construct
  misc_feature 1..9879: note = derived and/or modified CDS sequence (opt4) from DENV-1__GU131963__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccaggtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15964 - RNA, 9879 nt, synthetic construct
  misc_feature 1..9879: note = derived and/or modified CDS sequence (opt4) from DENV-1__KF955442__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgacggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15965 - RNA, 9879 nt, synthetic construct
  misc_feature 1..9879: note = derived and/or modified CDS sequence (opt4) from DENV-1__GU131965__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggtgctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaaacaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgccaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15966 - RNA, 9879 nt, synthetic construct
  misc_feature 1..9879: note = derived and/or modified CDS sequence (opt4) from DENV-1__GU131966__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacagaagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15967 - RNA, 9879 nt, synthetic construct
  misc_feature 1..9879: note = derived and/or modified CDS sequence (opt4) from DENV-1__GQ868501__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaaccagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaagaccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatcctgatggccacctacggctggaacctggtggagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15968 - RNA, 9879 nt, synthetic construct
  misc_feature 1..9879: note = derived and/or modified CDS sequence (opt4) from DENV-1__HQ166035__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatcagactgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccatgctggccgtgagcggcgtgtaccccatgagcatccccgccacccccttcgtgtggtacttctggcagaagaagaagcagagaatcagagtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagaggagaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15969 - RNA, 9879 nt, synthetic construct
  misc_feature 1..9879: note = derived and/or modified CDS sequence (opt4) from DENV-1__GQ868502__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcaccatcttcatcctgctgatgctggccacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagaccgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15970 - RNA, 9879 nt, synthetic construct
  misc_feature 1..9879: note = derived and/or modified CDS sequence (opt4) from DENV-1__GQ868503__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccagaacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggagagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagagaaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcatcttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15971 - RNA, 9879 nt, synthetic construct
  misc_feature 1..9879: note = derived and/or modified CDS sequence (opt4) from DENV-1__GQ868504__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagggcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtaccccgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15972 - RNA, 9879 nt, synthetic construct
  misc_feature 1..9879: note = derived and/or modified CDS sequence (opt4) from DENV-1__GU131967__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagacctgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacggcgagcccatccccctggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15973 - RNA, 9879 nt, synthetic construct
  misc_feature 1..9879: note = derived and/or modified CDS sequence (opt4) from DENV-1__GU131968__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccagaacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggagagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagagaaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15974 - RNA, 9879 nt, synthetic construct
  misc_feature 1..9879: note = derived and/or modified CDS sequence (opt4) from DENV-1__GQ868506__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccggcagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15975 - RNA, 9879 nt, synthetic construct
  misc_feature 1..9879: note = derived and/or modified CDS sequence (opt4) from DENV-1__GQ868507__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggatcaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcccagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15976 - RNA, 9879 nt, synthetic construct
  misc_feature 1..9879: note = derived and/or modified CDS sequence (opt4) from DENV-1__GQ868508__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggatcaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15977 - RNA, 9879 nt, synthetic construct
  misc_feature 1..9879: note = derived and/or modified CDS sequence (opt4) from DENV-1__GQ868509__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagatgagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcctgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15978 - RNA, 9879 nt, synthetic construct
  misc_feature 1..9879: note = derived and/or modified CDS sequence (opt4) from DENV-1__GQ868510__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcggccacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacatccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaaggacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctgggcaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15979 - RNA, 9879 nt, synthetic construct
  misc_feature 1..9879: note = derived and/or modified CDS sequence (opt4) from DENV-1__GQ868511__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgacctgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagaagaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacgcctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagcttctgggacctggtgcacaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatgggcgtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15980 - RNA, 9879 nt, synthetic construct
  misc_feature 1..9879: note = derived and/or modified CDS sequence (opt4) from DENV-1__GQ868512__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15981 - RNA, 9879 nt, synthetic construct
  misc_feature 1..9879: note = derived and/or modified CDS sequence (opt4) from DENV-1__GU131970__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagaccatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaaggacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccacccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgaaggagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15982 - RNA, 9879 nt, synthetic construct
  misc_feature 1..9879: note = derived and/or modified CDS sequence (opt4) from DENV-1__KF955427__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgcctggaccggcgccaccgagatccagaccagcggcaccaccaccatcttcgccggccacctgaagtggagactgaagatggacaagctgaccctgaagggcaccagctacgtgatgtgcaccggcagcttcaagctggagaaggaggtggccgagacccagcacggcaccggcctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctgcccgaccccctgatcgccggcggcatcctgatcgcctgctacgtgatcagcggcagcagcgccgacctgagcctggagaaggccgccgagatgagctgggagcaggaggccgagcacagcggcaccagccacaacatcctggtggaggtgcaggacgacggccccatgaagatcaaggacgaggagagagacgacaccctgaccatcctgctgaaggccaccctgctggccgtgagcggcgtgtaccccatgagcatccccggcaccctgttcgtgtggtacttctggcagaagaagaagcagagaagcggcgtgctgtgggacacccccagcccccccaaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcatcagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15983 - RNA, 9879 nt, synthetic construct
  misc_feature 1..9879: note = derived and/or modified CDS sequence (opt4) from DENV-1__GQ868513__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcccaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggatcaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15984 - RNA, 9879 nt, synthetic construct
  misc_feature 1..9879: note = derived and/or modified CDS sequence (opt4) from DENV-1__GU131973__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagatgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15985 - RNA, 9879 nt, synthetic construct
  misc_feature 1..9879: note = derived and/or modified CDS sequence (opt4) from DENV-1__GQ868517__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15986 - RNA, 9879 nt, synthetic construct
  misc_feature 1..9879: note = derived and/or modified CDS sequence (opt4) from DENV-1__GU131976__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcctgatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgaaggcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15987 - RNA, 9879 nt, synthetic construct
  misc_feature 1..9879: note = derived and/or modified CDS sequence (opt4) from DENV-1__GQ868518__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggccccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattcagaggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccagcagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15988 - RNA, 9879 nt, synthetic construct
  misc_feature 1..9879: note = derived and/or modified CDS sequence (opt4) from DENV-1__GQ868519__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggatcaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15989 - RNA, 9879 nt, synthetic construct
  misc_feature 1..9879: note = derived and/or modified CDS sequence (opt4) from DENV-1__KF955443__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagatgagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgtgaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcctgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaccctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15990 - RNA, 9879 nt, synthetic construct
  misc_feature 1..9879: note = derived and/or modified CDS sequence (opt4) from DENV-1__GQ868520__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15991 - RNA, 9879 nt, synthetic construct
  misc_feature 1..9879: note = derived and/or modified CDS sequence (opt4) from DENV-1__GQ868522__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggatcaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggcccccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15992 - RNA, 9879 nt, synthetic construct
  misc_feature 1..9879: note = derived and/or modified CDS sequence (opt4) from DENV-1__HQ166036__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattcagaggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccagcagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15993 - RNA, 9879 nt, synthetic construct
  misc_feature 1..9879: note = derived and/or modified CDS sequence (opt4) from DENV-1__GU131981__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcatggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggatcaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15994 - RNA, 9879 nt, synthetic construct
  misc_feature 1..9879: note = derived and/or modified CDS sequence (opt4) from DENV-1__GQ868529__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagaccgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagatcgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatgctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggcctgggccacgaggaccccatccccatggccacctacggctggaacctggtgaagctgctggccggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15995 - RNA, 9879 nt, synthetic construct
  misc_feature 1..9879: note = derived and/or modified CDS sequence (opt4) from DENV-1__GQ868531__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatcagcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15996 - RNA, 9879 nt, synthetic construct
  misc_feature 1..9879: note = derived and/or modified CDS sequence (opt4) from DENV-1__GU131983__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgatcggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgaggagatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15997 - RNA, 9879 nt, synthetic construct
  misc_feature 1..9879: note = derived and/or modified CDS sequence (opt4) from DENV-1__GQ868532__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggatcaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcaacagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccccccccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctgaccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccaacgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacggcatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15998 - RNA, 9879 nt, synthetic construct
  misc_feature 1..9879: note = derived and/or modified CDS sequence (opt4) from DENV-1__GQ868533__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcgaggccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcctgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccagcagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggccaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagagcagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 15999 - RNA, 9879 nt, synthetic construct
  misc_feature 1..9879: note = derived and/or modified CDS sequence (opt4) from DENV-1__GQ868534__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagaacgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16000 - RNA, 9879 nt, synthetic construct
  misc_feature 1..9879: note = derived and/or modified CDS sequence (opt4) from DENV-1__GQ868535__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtggccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacatgggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16001 - RNA, 9879 nt, synthetic construct
  misc_feature 1..9879: note = derived and/or modified CDS sequence (opt4) from DENV-1__KJ189306__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggccccttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagagagccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttccacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcatcagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16002 - RNA, 9879 nt, synthetic construct
  misc_feature 1..9879: note = derived and/or modified CDS sequence (opt4) from DENV-1__KJ189307__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatccccgtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagaacgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16003 - RNA, 9879 nt, synthetic construct
  misc_feature 1..9879: note = derived and/or modified CDS sequence (opt4) from DENV-1__KJ189318__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaagaccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16004 - RNA, 9879 nt, synthetic construct
  misc_feature 1..9879: note = derived and/or modified CDS sequence (opt4) from DENV-1__KJ189319__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16005 - RNA, 9879 nt, synthetic construct
  misc_feature 1..9879: note = derived and/or modified CDS sequence (opt4) from DENV-1__KJ189320__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcaccgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16006 - RNA, 9879 nt, synthetic construct
  misc_feature 1..9879: note = derived and/or modified CDS sequence (opt4) from DENV-1__KJ189323__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggccccttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccagggcggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgagacccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16007 - RNA, 9879 nt, synthetic construct
  misc_feature 1..9879: note = derived and/or modified CDS sequence (opt4) from DENV-1__KJ189324__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccagaagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgaggagatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16008 - RNA, 9879 nt, synthetic construct
  misc_feature 1..9879: note = derived and/or modified CDS sequence (opt4) from DENV-1__KJ189325__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcaccatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggatcaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccatgcccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16009 - RNA, 9879 nt, synthetic construct
  misc_feature 1..9879: note = derived and/or modified CDS sequence (opt4) from DENV-1__KJ189326__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcaccatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcctgtggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16010 - RNA, 9879 nt, synthetic construct
  misc_feature 1..9879: note = derived and/or modified CDS sequence (opt4) from DENV-1__KJ189327__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacacccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16011 - RNA, 9879 nt, synthetic construct
  misc_feature 1..9879: note = derived and/or modified CDS sequence (opt4) from DENV-1__KJ189328__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaaggacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccacccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatcgaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgaaggagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16012 - RNA, 9879 nt, synthetic construct
  misc_feature 1..9879: note = derived and/or modified CDS sequence (opt4) from DENV-1__KJ189329__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacgcctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagaagcggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccagcagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacagaacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16013 - RNA, 9879 nt, synthetic construct
  misc_feature 1..9879: note = derived and/or modified CDS sequence (opt4) from DENV-1__KJ189331__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgatcggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaagaccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggccatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16014 - RNA, 9879 nt, synthetic construct
  misc_feature 1..9879: note = derived and/or modified CDS sequence (opt4) from DENV-1__KJ189332__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcaccatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaagaccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggccatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16015 - RNA, 9879 nt, synthetic construct
  misc_feature 1..9879: note = derived and/or modified CDS sequence (opt4) from DENV-1__KJ189334__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaaggtgagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagaacgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16016 - RNA, 9879 nt, synthetic construct
  misc_feature 1..9879: note = derived and/or modified CDS sequence (opt4) from DENV-1__KJ189335__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagaacgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16017 - RNA, 9879 nt, synthetic construct
  misc_feature 1..9879: note = derived and/or modified CDS sequence (opt4) from DENV-1__KJ189336__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatcgtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16018 - RNA, 9879 nt, synthetic construct
  misc_feature 1..9879: note = derived and/or modified CDS sequence (opt4) from DENV-1__KJ189337__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagatctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagagaaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacgtgaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16019 - RNA, 9879 nt, synthetic construct
  misc_feature 1..9879: note = derived and/or modified CDS sequence (opt4) from DENV-1__KJ189340__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccggcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16020 - RNA, 9879 nt, synthetic construct
  misc_feature 1..9879: note = derived and/or modified CDS sequence (opt4) from DENV-1__KJ189341__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcggccacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggccccttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgtggtgggcatcgtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacacccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaaggacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccagcaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcatccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagctgcactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16021 - RNA, 9879 nt, synthetic construct
  misc_feature 1..9879: note = derived and/or modified CDS sequence (opt4) from DENV-1__KJ189343__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtggtgaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgatcggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaagaccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggccatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccaccttcgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16022 - RNA, 9879 nt, synthetic construct
  misc_feature 1..9879: note = derived and/or modified CDS sequence (opt4) from DENV-1__KJ189344__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtggtgaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16023 - RNA, 9879 nt, synthetic construct
  misc_feature 1..9879: note = derived and/or modified CDS sequence (opt4) from DENV-1__KJ189346__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagatgagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgatggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcctgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccagcagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggccaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccaccgcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcctgcagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16024 - RNA, 9879 nt, synthetic construct
  misc_feature 1..9879: note = derived and/or modified CDS sequence (opt4) from DENV-1__KJ189347__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggccccttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctgatggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgagacccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcagatgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16025 - RNA, 9879 nt, synthetic construct
  misc_feature 1..9879: note = derived and/or modified CDS sequence (opt4) from DENV-1__KJ189348__SS-prME
  source 1..9879: mol_type = other RNA
agcgtgaccatgctgctgatgctgctgcccaccgccctggccttccacctgaccaccagaggcggcgagccccacatgatcgtgagcaagcacgagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcttcagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctgaactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16026 - RNA, 9879 nt, synthetic construct
  misc_feature 1..9879: note = derived and/or modified CDS sequence (opt4) from DENV-1__KJ189368__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaacggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggccccttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcatcagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagttcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgttcgactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16027 - RNA, 9879 nt, synthetic construct
  misc_feature 1..9879: note = derived and/or modified CDS sequence (opt4) from DENV-1__KJ189369__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagaacgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgagatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16028 - RNA, 9879 nt, synthetic construct
  misc_feature 1..9879: note = derived and/or modified CDS sequence (opt4) from DENV-1__EU482615__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagagcgagagcgaccccgagggcgccctgtggtga

SEQ ID NO: 16029 - RNA, 9879 nt, synthetic construct
  misc_feature 1..9879: note = derived and/or modified CDS sequence (opt4) from DENV-1__EU482616__SS-prME
  source 1..9879: mol_type = other RNA
agcgtgaccatgctgctgatgctgctgcccaccgccctggccttccacctgaccaccagaggcggcgagccccacatgatcgtgaacaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16030 - RNA, 9879 nt, synthetic construct
  misc_feature 1..9879: note = derived and/or modified CDS sequence (opt4) from DENV-1__EU482618__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16031 - RNA, 9879 nt, synthetic construct
  misc_feature 1..9879: note = derived and/or modified CDS sequence (opt4) from DENV-1__EU482619__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16032 - RNA, 9879 nt, synthetic construct
  misc_feature 1..9879: note = derived and/or modified CDS sequence (opt4) from DENV-1__FJ898433__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacagctgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaaggacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccacccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctgggcaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgaaggagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16033 - RNA, 9879 nt, synthetic construct
  misc_feature 1..9879: note = derived and/or modified CDS sequence (opt4) from DENV-1__FJ547088__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccggcagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16034 - RNA, 9879 nt, synthetic construct
  misc_feature 1..9879: note = derived and/or modified CDS sequence (opt4) from DENV-1__FJ810419__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16035 - RNA, 9879 nt, synthetic construct
  misc_feature 1..9879: note = derived and/or modified CDS sequence (opt4) from DENV-1__FJ547068__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggccgccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16036 - RNA, 9879 nt, synthetic construct
  misc_feature 1..9879: note = derived and/or modified CDS sequence (opt4) from DENV-1__FJ562104__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16037 - RNA, 9879 nt, synthetic construct
  misc_feature 1..9879: note = derived and/or modified CDS sequence (opt4) from DENV-1__GQ199857__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16038 - RNA, 9879 nt, synthetic construct
  misc_feature 1..9879: note = derived and/or modified CDS sequence (opt4) from DENV-1__GQ199858__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggcctgggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16039 - RNA, 9879 nt, synthetic construct
  misc_feature 1..9879: note = derived and/or modified CDS sequence (opt4) from DENV-1__GQ199859__SS-prME
  source 1..9879: mol_type = other RNA
agcgtgaccatgctgctgatgctgctgcccaccgccctggccttccacctgaccaccagaggcggcgagccccacatgatcgtgagcaagcacgagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgtacctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16040 - RNA, 9879 nt, synthetic construct
  misc_feature 1..9879: note = derived and/or modified CDS sequence (opt4) from DENV-1__JF937645__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16041 - RNA, 9879 nt, synthetic construct
  misc_feature 1..9879: note = derived and/or modified CDS sequence (opt4) from DENV-1__FJ850114__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccagccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagacctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagatcctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgatcagcatgaagagattcaagaacgagagcgaccccgagggcgccctgtggtga

SEQ ID NO: 16042 - RNA, 9879 nt, synthetic construct
  misc_feature 1..9879: note = derived and/or modified CDS sequence (opt4) from DENV-1__JN819402__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatgaccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagactgatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagagcgagagcgaccccgagggcgccctgtggtga

SEQ ID NO: 16043 - RNA, 9879 nt, synthetic construct
  misc_feature 1..9879: note = derived and/or modified CDS sequence (opt4) from DENV-1__FJ850113__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagactgatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagagcgagagcgaccccgagggcgccctgtggtga

SEQ ID NO: 16044 - RNA, 9879 nt, synthetic construct
  misc_feature 1..9879: note = derived and/or modified CDS sequence (opt4) from DENV-1__JF937635__SS-prME
  source 1..9879: mol_type = other RNA
agcgtgaccatgctgctgatgctgatgcccaccgccctggccttccacctgaccaccagaggcggcgagccccacatgatcgtgagcaagcacgagagaggcaaggccctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccccccccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16045 - RNA, 9879 nt, synthetic construct
  misc_feature 1..9879: note = derived and/or modified CDS sequence (opt4) from DENV-1__FJ024483__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctactacacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16046 - RNA, 9879 nt, synthetic construct
  misc_feature 1..9879: note = derived and/or modified CDS sequence (opt4) from DENV-1__EU596504__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcttcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatgccccccgagaagtgcgacaccctgctgtgcgacatcggcgagagcagccccaaccccaccatcgaggagggcagaaccctgagaatcctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16047 - RNA, 9879 nt, synthetic construct
  misc_feature 1..9879: note = derived and/or modified CDS sequence (opt4) from DENV-1__FJ024481__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatgccccccgagaagtgcgacaccctgctgtgcgacatcggcgagagcagccccaaccccaccatcgaggagggcagaaccctgagaatcctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16048 - RNA, 9879 nt, synthetic construct
  misc_feature 1..9879: note = derived and/or modified CDS sequence (opt4) from DENV-1__GQ199872__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggaccacatgaccagcatgaagagattcaagaacgagagcgaccccgagggcgccctgtggtga

SEQ ID NO: 16049 - RNA, 9879 nt, synthetic construct
  misc_feature 1..9879: note = derived and/or modified CDS sequence (opt4) from DENV-1__FJ410290__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccagccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggtggtgttcctgctgctgatcatgggccagctgacctggaaggacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagattcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctgggcaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccaccaacgccaagtgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgagaagattcaagaacgagagcgaccccgagggcgccctgtggtga

SEQ ID NO: 16050 - RNA, 9879 nt, synthetic construct
  misc_feature 1..9879: note = derived and/or modified CDS sequence (opt4) from DENV-1__FJ024423__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtggtggccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccatcatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16051 - RNA, 9879 nt, synthetic construct
  misc_feature 1..9879: note = derived and/or modified CDS sequence (opt4) from DENV-1__FJ547089__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagaccatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcgtgcccgccagagaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16052 - RNA, 9879 nt, synthetic construct
  misc_feature 1..9879: note = derived and/or modified CDS sequence (opt4) from DENV-1__FJ024484__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtggtggccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgccagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgaccaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacggcttcttcatgccccccgagaagtgcggcaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16053 - RNA, 9879 nt, synthetic construct
  misc_feature 1..9879: note = derived and/or modified CDS sequence (opt4) from DENV-1__EU596503__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcatcggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcatgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcaccggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16054 - RNA, 9879 nt, synthetic construct
  misc_feature 1..9879: note = derived and/or modified CDS sequence (opt4) from DENV-1__FJ024479__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcttcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccgccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgccagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaccacccccgagggcatcatccccgccctgttcgagcccgagagagagaagagcgccgccatcgacggcgagagcagactgagaggcgagcccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggcccaaggagggcgagagaaagaagctgagacccagatggctggacgccagaacctacagcgaccccctggccctgggcgagttcaaggagttcggcgccggcagaagaagcggcagcggcgccctgatcctggagatcggcaagctgccccagcacctgcccctgagagcccagaacggcctggacaacctggtgatggtgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggccaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtggaccagccagatcctgctgatgagaaccacctgggccctgggcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaaccccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagaggcctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatggactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtggtggtggacgagaaccagtggaacagcgccaaggaggccggcgaggacgagagagtgtgggacctgggcgacagagagagagagctgcacaagcagggcaagtgcgccacctgcggctacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagcccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtggccttctggagccaccacttccaccagctgatcatgaaggacggcagagagatcgtggtgccctgcagaaaccaggacgagctgggcggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16055 - RNA, 9879 nt, synthetic construct
  misc_feature 1..9879: note = derived and/or modified CDS sequence (opt4) from DENV-1__FJ182002__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcaccggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaacccagaccaaggagggcgaccagtacgtgtacatgggccagcccctgaacaacgacgaggaccacgcccactggaccgaggccaagatgctgctggccaacatcaacacccccgagggcatcatccccgccctgttcgagcccgagagagagaagagccccgccatcgacggcgagtacagactgagaggcgaggccagaaagaccttcgtggagctgatgagaagaggcgacctgcccgtgtggctgagctacaaggtggccagcgagggcttccagtacagcgacagaagatggtggttcgacggcgagagaaacaaccaggtgctggaggagaacatggacgtggagatctggaccaaggagggcgagagaaagaagctgagacccagatggctggacgccagaacctacagcgaccccctggccctgggcgagttcaaggagttcggcgccggcagaagaagcggcagcggcgacctgatcctggagatcggcaagctgccccagcacctgaccctgagagcccagaacggcctggacaacctggtgatggtgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccggcgaggacgagagagtgtgggacctggtggacagagagagagagctgcacaagcagggcaagtggggcaccggcggctacaacatgatgggcaagagagagaagaagctgggcgagttcggcaaggccaagggcagcagaggcatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatgcccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctggagccaccacttccaccagctgatcatgaaggacggcagagagatcgtggtgccctgcagaaaccaggacgagctggtgggcagagccagagtgagccagggcgccggctggagcctgagagagaccgcctggctgggcaagagctacgcccagatgggccagctgatgtacttccacagaagagacctgagactggccgccaacgccatctggagcgccggccccggcgactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16056 - RNA, 9879 nt, synthetic construct
  misc_feature 1..9879: note = derived and/or modified CDS sequence (opt4) from DENV-1__FJ024482__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggcccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatggtgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcctgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagcccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgccatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16057 - RNA, 9879 nt, synthetic construct
  misc_feature 1..9879: note = derived and/or modified CDS sequence (opt4) from DENV-1__EU596501__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgctgcccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccctggagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcagccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16058 - RNA, 9879 nt, synthetic construct
  misc_feature 1..9879: note = derived and/or modified CDS sequence (opt4) from DENV-1__FJ898437__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgtgaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16059 - RNA, 9879 nt, synthetic construct
  misc_feature 1..9879: note = derived and/or modified CDS sequence (opt4) from DENV-1__FJ024480__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctgatggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16060 - RNA, 9879 nt, synthetic construct
  misc_feature 1..9879: note = derived and/or modified CDS sequence (opt4) from DENV-1__FJ873814__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtggtggccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccatcatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagagcatccccatggccacctacgcctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16061 - RNA, 9879 nt, synthetic construct
  misc_feature 1..9879: note = derived and/or modified CDS sequence (opt4) from DENV-1__JN819403__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgagggccccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16062 - RNA, 9879 nt, synthetic construct
  misc_feature 1..9879: note = derived and/or modified CDS sequence (opt4) from DENV-1__KF973453__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16063 - RNA, 9879 nt, synthetic construct
  misc_feature 1..9879: note = derived and/or modified CDS sequence (opt4) from DENV-1__KF973454__SS-prME
  source 1..9879: mol_type = other RNA
agcgtgaccatgctgctgatgctgctgcccaccgccctggccttccacctgaccaccagaggcggcgagccccacatgatcgtgagcaagcacgagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctggccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagctgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccatctgcctgagcaccaccagccagaagaccacctggctgcccgtgctgctgggcagcttcggctgcaagcccctgaccatgtacctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagagcgccctggacaacctggtgatgctgcacaacagcgagcagggcggcaaggcctacagacacgccatggaggagctgcccgacaccatcgagaccctgatgctgctggccctgatcgccgtgctgaccggcggcgtgatgctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtgaccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgtgctgtggtga

SEQ ID NO: 16064 - RNA, 9879 nt, synthetic construct
  misc_feature 1..9879: note = derived and/or modified CDS sequence (opt4) from DENV-1__KF973455__SS-prME
  source 1..9879: mol_type = other RNA
agcgtgaccatgctgctgatgctgctgcccaccgccctggccttccacctgaccaccagaggcggcgagccccacatgatcgtgagcaagcacgagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctggccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagctgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccatctgcctgagcaccaccagccagaagaccacctggctgcccgtgctgctgggcagcttcggctgcaagcccctgaccatgtacctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgatgctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtgaccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16065 - RNA, 9879 nt, synthetic construct
  misc_feature 1..9879: note = derived and/or modified CDS sequence (opt4) from DENV-1__KF973456__SS-prME
  source 1..9879: mol_type = other RNA
agcgtgaccatgctgctgatgctgctgcccaccgccctggccttccacctgaccaccagaggcggcgagccccacatgatcgtgagcaagcacgagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctggccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagctgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccatctgcctgagcaccaccagccagaagaccacctggctgcccgtgctgctgggcagcttcggctgcaagcccctgaccatgtacctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgatgctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtgaccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16066 - RNA, 9879 nt, synthetic construct
  misc_feature 1..9879: note = derived and/or modified CDS sequence (opt4) from DENV-1__KF973459__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcctgagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggtgagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16067 - RNA, 9879 nt, synthetic construct
  misc_feature 1..9879: note = derived and/or modified CDS sequence (opt4) from DENV-1__KF973460__SS-prME
  source 1..9879: mol_type = other RNA
agcgtgaccatgctgctgatgctgctgcccaccgccctggccttccacctgaccaccagaggcggcgagccccacatgatcgtgagcaagcacgagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctggccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcctgagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagctgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgtacttcatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcatcagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagagctacctggactacatgaccagcatgaagagattcaagaacgagagcgaccccgagggcgccctgtggtga

SEQ ID NO: 16068 - RNA, 9879 nt, synthetic construct
  misc_feature 1..9879: note = derived and/or modified CDS sequence (opt4) from DENV-1__KF973461__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatgggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgagctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagatcaccgccatggccctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16069 - RNA, 9879 nt, synthetic construct
  misc_feature 1..9879: note = derived and/or modified CDS sequence (opt4) from DENV-1__KF973462__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccctgacctacaagtgcccccagatcatcgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggagatggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggtgagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgagactgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccaagagagtgctggactggctggagaagcacggcgccgagagactgaagagaatggccatcagcggcgacgactgcgtggtgaagcccatcgacgacagattcgccaccgccctgaccgccctgaacgacatgggcaagatcagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16070 - RNA, 9879 nt, synthetic construct
  misc_feature 1..9879: note = derived and/or modified CDS sequence (opt4) from DENV-1__KF973463__SS-prME
  source 1..9879: mol_type = other RNA
agcgtgaccatgctgctgatgctgatgcccaccgccctggccttccacctgaccaccagaggcggcgagccccacatgatcgtgagcaagcacgagagaggcaaggccctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagaagaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16071 - RNA, 9879 nt, synthetic construct
  misc_feature 1..9879: note = derived and/or modified CDS sequence (opt4) from DENV-1__KF973464__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcatcttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatggtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16072 - RNA, 9879 nt, synthetic construct
  misc_feature 1..9879: note = derived and/or modified CDS sequence (opt4) from DENV-1__KF973465__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatgggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgagctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16073 - RNA, 9879 nt, synthetic construct
  misc_feature 1..9879: note = derived and/or modified CDS sequence (opt4) from DENV-1__KF973466__SS-prME
  source 1..9879: mol_type = other RNA
agcgtgaccatgctgctgatgctgatgcccaccgccctggccttccacctgaccaccagaggcggcgagccccacatgatcgtgagcaagcacgagagaggcaaggccctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16074 - RNA, 9879 nt, synthetic construct
  misc_feature 1..9879: note = derived and/or modified CDS sequence (opt4) from DENV-1__KF973471__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgcccccagatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacaaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgccagcatcatgatcgaggaggtgatgagaagcagatggagcagaaagatgctgatgaccggcacccccgccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgaccgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacaccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccgtggaggagggcagaaccctgagagtgctgaagatggtggagccctggctgaagggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16075 - RNA, 9879 nt, synthetic construct
  misc_feature 1..9879: note = derived and/or modified CDS sequence (opt4) from DENV-1__KF973472__SS-prME
  source 1..9879: mol_type = other RNA
agcgtgaccatgctgctgatgctgctgcccaccgccctggccttccacctgaccaccagaggcggcgagccccacatgatcgtgagcaagcacgagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctggccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcgtgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagctgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcagaaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgtacttcatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgagagacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagagctacctggactacatgaccagcatgaagagattcaagaacgagagcgaccccgagggcgccctgtggtga

SEQ ID NO: 16076 - RNA, 9879 nt, synthetic construct
  misc_feature 1..9879: note = derived and/or modified CDS sequence (opt4) from DENV-1__KF973474__SS-prME
  source 1..9879: mol_type = other RNA
agcgtgaccatgctgctgatgctgctgcccaccgccctggccttccacctgaccaccagaggcggcgagccccacatgatcgtgagcaagcacgagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctggccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagctgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgtacctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccgtgagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtgaccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16077 - RNA, 9879 nt, synthetic construct
  misc_feature 1..9879: note = derived and/or modified CDS sequence (opt4) from DENV-1__KF973475__SS-prME
  source 1..9879: mol_type = other RNA
agcgtgaccatgctgctgatgctgatgcccaccgccctggccttccacctgaccaccagaggcggcgagccccacatgatcgtgagcaagcacgagagaggcaaggccctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacggcatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcatcctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgagaatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16078 - RNA, 9879 nt, synthetic construct
  misc_feature 1..9879: note = derived and/or modified CDS sequence (opt4) from DENV-1__FJ898448__SS-prME
  source 1..9879: mol_type = other RNA
agcgtgaccatgctgctgatgctgctgcccaccgtgctgaccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgacgacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatcagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactggtgaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcaagaagaccatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggtggtgttcctgctgctgaccctgggccagctgacctggaacgacctgatcagactgtgcatcatggtgggcgccaacgccagcgacaacatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggacgagctgggcgacggcctggccatgggcatcatgatcctgaagctgctgaccgacttccagagccaccagctgtgggccaccctgctgagcctgaccttcgtgaagaccaccctgagcctgcactacgcctggaagaccatggccatgatcctgagcatcgtgagcctgctgcccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccaaggtgagctgggaggaggaggccgagcacagcggcgccagccacaacatcctggtggagatccaggacgacggcaccatgaagatcaaggacgaggagagagacgacaccatcaccatcctgctgaaggccaccctgctggccatcagcggcgtgtaccccatgagcatccccgccaccctgttcgtgtggcacttctggcagaagaagaagcagagaagcggcgtgctgtgggacacccccagcccccccgaggtggagaaggccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagaaggacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccatcatgctgctggccctgatcgccgtgctgaccggcggcgtgaccctgttcttcctgagcggcagaggcctgggcaagaccagcatcggcctgctgtgcgtgaccagcagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcaccgagagactgagaagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16079 - RNA, 9879 nt, synthetic construct
  misc_feature 1..9879: note = derived and/or modified CDS sequence (opt4) from DENV-1__GQ868602__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgagacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacaccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcagactgatcaccgccaaccccatcgtgaccgacaaggagaagcccgtgaacatcgaggccgagccccccttcggcgagagctacctggtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctgatccaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgaacggcgtgctggcccagggcaagaagatgatcagaccccagcccatggagcacaagtacagctggaagagctggggcaaggccaaggtgatcggcgccgacgtgcagaacatcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctgaccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcggcctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacaagatgggcatgggcaccacctacctggccctgatggccaccttcagaatgagacccatgttcgccgtgggcctgctgttcagaagactgaccagcagagaggtgctgctgctgaccgtgggcctgagcctggtggccagcgtggagctgcccaacagcctggaggagctgggcgacggcctggccatgggcatcatgatgctgaagctgctgaccgacttccagagccaccagctgtgggccaccctgctgagcctgaccttcgtgaagaccaccttcagcctgcactacgcctggaagaccatggccatgatcctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcaagagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacatgggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctggtgctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcatggaggccttcccccagagcaacgccgccatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtggtgcagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctgctgaagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagagccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatcgaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaaggtgctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagaaacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcatcgacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagaacgaccccgagggcgccctgtggtga

SEQ ID NO: 16080 - RNA, 9879 nt, synthetic construct
  misc_feature 1..9879: note = derived and/or modified CDS sequence (opt4) from DENV-1__KF921911__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggaacagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgagcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgtacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16081 - RNA, 9879 nt, synthetic construct
  misc_feature 1..9879: note = derived and/or modified CDS sequence (opt4) from DENV-1__KJ189350__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaacggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16082 - RNA, 9879 nt, synthetic construct
  misc_feature 1..9879: note = derived and/or modified CDS sequence (opt4) from DENV-1__KJ189351__SS-prME
  source 1..9879: mol_type = other RNA
agcgtgaccatgctgctgatgctgctgcccaccgtgctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggacccccggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgaccagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcgccgagaacagaatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcgtgaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagagcagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16083 - RNA, 9879 nt, synthetic construct
  misc_feature 1..9879: note = derived and/or modified CDS sequence (opt4) from DENV-1__KJ189352__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaaggtgatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16084 - RNA, 9879 nt, synthetic construct
  misc_feature 1..9879: note = derived and/or modified CDS sequence (opt4) from DENV-1__KJ189353__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgagctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16085 - RNA, 9879 nt, synthetic construct
  misc_feature 1..9879: note = derived and/or modified CDS sequence (opt4) from DENV-1__KJ189354__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagaagttctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16086 - RNA, 9879 nt, synthetic construct
  misc_feature 1..9879: note = derived and/or modified CDS sequence (opt4) from DENV-1__KJ189355__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgatcgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcatgagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctgggctggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16087 - RNA, 9879 nt, synthetic construct
  misc_feature 1..9879: note = derived and/or modified CDS sequence (opt4) from DENV-1__KJ189358__SS-prME
  source 1..9879: mol_type = other RNA
agcgtgaccatgctgctgatgctgctgcccaccgtgctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacccacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccctaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagagaaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaaagtacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgcccagctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagaacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16088 - RNA, 9879 nt, synthetic construct
  misc_feature 1..9879: note = derived and/or modified CDS sequence (opt4) from DENV-1__KJ189359__SS-prME
  source 1..9879: mol_type = other RNA
agcgtgaccatgctgctgatgctgctgcccaccgtgctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagagaaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacaccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatcgacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacaccgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16089 - RNA, 9879 nt, synthetic construct
  misc_feature 1..9879: note = derived and/or modified CDS sequence (opt4) from DENV-1__KJ189360__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16090 - RNA, 9879 nt, synthetic construct
  misc_feature 1..9879: note = derived and/or modified CDS sequence (opt4) from DENV-1__KJ189361__SS-prME
  source 1..9879: mol_type = other RNA
agcgtgaccatgctgctgatgctgctgcccaccgccatggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16091 - RNA, 9879 nt, synthetic construct
  misc_feature 1..9879: note = derived and/or modified CDS sequence (opt4) from DENV-1__KJ189362__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcatgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgagaaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16092 - RNA, 9879 nt, synthetic construct
  misc_feature 1..9879: note = derived and/or modified CDS sequence (opt4) from DENV-1__KJ189363__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcatggtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16093 - RNA, 9879 nt, synthetic construct
  misc_feature 1..9879: note = derived and/or modified CDS sequence (opt4) from DENV-1__KJ189364__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcatgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgagaaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggagcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16094 - RNA, 9879 nt, synthetic construct
  misc_feature 1..9879: note = derived and/or modified CDS sequence (opt4) from DENV-1__KJ189365__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgtggtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgacgagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16095 - RNA, 9879 nt, synthetic construct
  misc_feature 1..9879: note = derived and/or modified CDS sequence (opt4) from DENV-1__KJ189366__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcgccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacagcgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgccgccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgtgaccatgctggacgtggacctgcaccccgccagcgcctggaccctgtacgccgtggccaccaccgtgatcacccccatgatgagacacaccatcgagaacgccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccgtggaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccgtgggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagagtgaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggagaacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16096 - RNA, 9879 nt, synthetic construct
  misc_feature 1..9879: note = derived and/or modified CDS sequence (opt4) from DENV-1__JN819417__SS-prME
  source 1..9879: mol_type = other RNA
agcgtgaccatgctgctgatgctgctgcccaccgccctggccttccacctgaccaccagaggcggcgagccccacatggtggtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagcacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccacgagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccagcggcatcctggcccagggcaagaagatgatcagaccccagcccatggagcacaagtacagctggaagagctggggcaaggccaagatcatcggcgccgacacccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatgggcaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgagatcagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccatctggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcatcagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagaaggacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccaagaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaacgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16097 - RNA, 9879 nt, synthetic construct
  misc_feature 1..9879: note = derived and/or modified CDS sequence (opt4) from DENV-1__FJ687426__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccggcgccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16098 - RNA, 9879 nt, synthetic construct
  misc_feature 1..9879: note = derived and/or modified CDS sequence (opt4) from DENV-1__FJ687428__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccggcgccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagagcatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16099 - RNA, 9879 nt, synthetic construct
  misc_feature 1..9879: note = derived and/or modified CDS sequence (opt4) from DENV-1__FJ687429__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctggatcgacgtggtgctggagcacggcagctgcatcaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16100 - RNA, 9879 nt, synthetic construct
  misc_feature 1..9879: note = derived and/or modified CDS sequence (opt4) from DENV-1__FJ850068__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacagcaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccggcgccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaaggccggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccatcgacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgacagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccaacgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagaccagaatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgagcccgagggcgccctgtggtga

SEQ ID NO: 16101 - RNA, 9879 nt, synthetic construct
  misc_feature 1..9879: note = derived and/or modified CDS sequence (opt4) from DENV-1__FJ687430__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccatcctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacaagatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccctggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccagcatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagaccgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16102 - RNA, 9879 nt, synthetic construct
  misc_feature 1..9879: note = derived and/or modified CDS sequence (opt4) from DENV-1__FJ687432__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcaccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccatcctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacgccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccctggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccagcatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagaccgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16103 - RNA, 9879 nt, synthetic construct
  misc_feature 1..9879: note = derived and/or modified CDS sequence (opt4) from DENV-1__JQ922547__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccccctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaactgcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccacccacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtggtgggcgccggcgagaaggccctgaagctgagctggttcaagaagggcagcagcatcggcaagatgctggaggccaccgccagaggcgccagaagaatggccatcctgggcgacaccgcctgggacttcggcagcatcggcggcgtgttcaccagcatgggcaagctggtgcaccaggtgttcggcaccgcctacggcgtgctgttcagcggcgtgagctggaccatgaagatcggcatcggcatcctgctgacctggctgggcctgaacagcagaaacaccagcctgagcatgatgtgcatcgccgtgggcatggtgaccctgtacctgggcgtgatggtgcaggccgacagcggctgcgtgatcaactggaagggcagagagctgctgtgcggcaccggcatcttcgtgaccaacgaggtgcacacctggaccgacccctacaagttccaggccgaccccagcaacagactgagccccatcatcggcaaggcctgcgtgatcagagtgtgcggcatcagaagcgccaccagactggagaacatcatgtggaagcagatcagcaacgagctgaaccacatcctgctggagaacgacatgaagttcaccgtggtggtgggcgacgtgagcggcatcctggcccagggcgagaagatgatcagaccccagcccatggagcacaagtacagctggaagagctggggcaaggccaagatcatcggcgccgacgtgcagaacaccaccttcatcatcgacggccccaacacccccgagtgccccgacaaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacttctgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggacaaggaggagaacctggtgaagagcatggtgagcgccggcagcggcgaggtggacagcttcagcctgggcctgctgtgcatcagcatcatgatcgaggaggtgatgagaagcagatggagcaagaagatgctgatggtgggcaccctggccgtgttcctgctgctgatcatgggccagctgacctggagcgacctgatcagactgtgcatcatggtgggcgccaacgccagcgacagaatgggcatgggcaccacctacctggccctgatggccaccttcaagatgagacccatgttcgccgtgggcctgctgttccccaagctgaccagcagagaggtgctgctgctgaccatcggcctgagcctggtggccagcgtggagctgcccagcagcctggaggagctgggcgacggcctggccaagggcatcatgatgctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgcccatgttcctgatcaccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctggtggcctgctacgtgatcagcggcagcagcgccgacctgagcctggagaaggccgccgaggtgagctgggaggaggaggccgagcacagcggcgccagccacaacatcctggtggaggtgcaggacgacggcaccagaaagatcaaggacgaggagagagacgacaccctgaccatcctgctgaaggccaccctgctggccgtgagcggcgtgtaccccatgagcatccccgccaccctgttcgtgtggtacttctggcagaagaagaaccagagaagcggcgtgggcctgatcacccccagcccccccgaggtggagagagccgtgctggacgacggcatctacagaatcctgcagagaggcctgctgggcagaagccaggtgggcgtgggcgtgttccaggagggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcagaaaccccaagaacgtgcagaccgcccccggcaccttcaagacccccgagggcgaggtgggcgccatccccctggacttcaagcccggcaccagcggcagccccatcgtgaacagagagggcaagatcgtgggcctgtacggcaacggcgtggtgaccaccagcggcacctacgtgagcgccatcgccagagccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcgtgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccacccccaccggcagcgtggaggccttcccccagagcaacgccatcatccaggacgaggagagagacatccccgagagaagctggaacagcggctacgactggatcaccgacttccccggcaagaccgtgtggttcgtgcccagcatcaagagcggcaacgacatcgccaactgcctgaagaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccagcaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacaaggacgtggagatctggaccaaggagggcgagagaaagaagctgagaacctgctggctggacgccagaacctacagcgaccccctggccctgagagagttcaaggagttcgccgccggcagaagaagcgtgagcggcgacctgatcctggagatcggcaagctgccccagcacctgacccagaaggcccagaaggccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcagattctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacaagatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcagaatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgccatcagcagaagagaccagagaggcagcggccaggtgggcacctacggcctgaacaccttcctgcacaaggaggcccagctgatcagacagatggagttcgagggcatcttcctgcccagcgagctggagacccccaacctggccggcagagtgctggactggctggagcagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggggcgactggcagcaggtgcccttctgcagccaccacttccaccagctgatcatgaaggacgtgagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16104 - RNA, 9879 nt, synthetic construct
  misc_feature 1..9879: note = derived and/or modified CDS sequence (opt4) from DENV-1__EU482567__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatcctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgccggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtggtggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacgccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaaggacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaacaccaccctgagcctggactacgcctggagaaccatggccatggtgctgagcatcatcagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccagagagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctggaacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgagagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16105 - RNA, 9879 nt, synthetic construct
  misc_feature 1..9879: note = derived and/or modified CDS sequence (opt4) from DENV-1__FJ390378__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacagcaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctgaactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16106 - RNA, 9879 nt, synthetic construct
  misc_feature 1..9879: note = derived and/or modified CDS sequence (opt4) from DENV-1__FJ205872__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacagcaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgccctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctgaactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16107 - RNA, 9879 nt, synthetic construct
  misc_feature 1..9879: note = derived and/or modified CDS sequence (opt4) from DENV-1__FJ205873__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacagcaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaaagctgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaaggtggtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctgaactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16108 - RNA, 9879 nt, synthetic construct
  misc_feature 1..9879: note = derived and/or modified CDS sequence (opt4) from DENV-1__FJ390379__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcagaaagatgatcagaccccagcccatggagcacagatacagctggaagagctggggcaaggccaagatcatcggcgccgacatccagaacagcaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16109 - RNA, 9879 nt, synthetic construct
  misc_feature 1..9879: note = derived and/or modified CDS sequence (opt4) from DENV-1__FJ390380__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacagcaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgagctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggtggtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccttcttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctgaactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16110 - RNA, 9879 nt, synthetic construct
  misc_feature 1..9879: note = derived and/or modified CDS sequence (opt4) from DENV-1__FJ205874__SS-prME
  source 1..9879: mol_type = other RNA
agcgtgaccatgctgctgatgctgctgcccaccgtgctggccttccacctgaccaccagaggcggcgagccccacatgatcgtgggcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccctgagcacccaggacgagaagggcgtgacccagaacggcagactgatcaccgccaaccccatcgtgaccgacaaggagaagcccgtgaacatcgagaccgagccccccttcggcgagagctacatcatcgtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcgccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcgtgagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggagactggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcctgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccgtggccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggagcagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgaagagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgatgctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgtgaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaagacacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctgggcatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtgggacttcctgagcagaaacaagaagcccagaatctgcaccagagaggagttcatcagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagaccaccaacctggccgagagagtgctggactggctggagaagcacggcgtggagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16111 - RNA, 9879 nt, synthetic construct
  misc_feature 1..9879: note = derived and/or modified CDS sequence (opt4) from DENV-1__FJ205875__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcaagaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggagcaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggctggtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggtgcacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgacggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16112 - RNA, 9879 nt, synthetic construct
  misc_feature 1..9879: note = derived and/or modified CDS sequence (opt4) from DENV-1__FJ410173__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacagcaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccttcttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctgaactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16113 - RNA, 9879 nt, synthetic construct
  misc_feature 1..9879: note = derived and/or modified CDS sequence (opt4) from DENV-1__FJ410174__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatcgccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcatcacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccgccctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggaggccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16114 - RNA, 9879 nt, synthetic construct
  misc_feature 1..9879: note = derived and/or modified CDS sequence (opt4) from DENV-1__FJ410175__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16115 - RNA, 9879 nt, synthetic construct
  misc_feature 1..9879: note = derived and/or modified CDS sequence (opt4) from DENV-1__FJ562105__SS-prME
  source 1..9879: mol_type = other RNA
agcgtgaccatgctgctgatgctgctgcccaccgtgctggccttccacctgaccaccagaggcggcgagccccacatgatcgtgggcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccctgagcacccaggacgagaagggcgtgacccagaacggcagactgatcaccgccaaccccatcgtgaccgacaaggagaagcccgtgaacatcgagaccgagccccccttcggcgagagctacatcatcgtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcgccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcgtgagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcctgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccgtggccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgatgctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgtgaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgggcggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctgggcatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtgggacttcctgagcagaaacaagaagcccagaatctgcaccagagaggagttcatcagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagaccaccaacctggccgagagagtgctggactggctggagaagcacggcgtggagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16116 - RNA, 9879 nt, synthetic construct
  misc_feature 1..9879: note = derived and/or modified CDS sequence (opt4) from DENV-1__FJ562106__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcatggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcgccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaagaacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcggcctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccttcagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgccctgcgagctggagacccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccaccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16117 - RNA, 9879 nt, synthetic construct
  misc_feature 1..9879: note = derived and/or modified CDS sequence (opt4) from DENV-1__FJ410179__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacagcaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccatcagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16118 - RNA, 9879 nt, synthetic construct
  misc_feature 1..9879: note = derived and/or modified CDS sequence (opt4) from DENV-1__FJ410181__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgtacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16119 - RNA, 9879 nt, synthetic construct
  misc_feature 1..9879: note = derived and/or modified CDS sequence (opt4) from DENV-1__FJ547086__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcatggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcgccagcctgagcatgacctgcatcgccgtgggcatggtgaccctgtacctgggcgtgatggtgcaggccgacagcggctgcgccatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccagcagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgccctgcgagctggagacccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcaaccccgagggcgccctgtggtga

SEQ ID NO: 16120 - RNA, 9879 nt, synthetic construct
  misc_feature 1..9879: note = derived and/or modified CDS sequence (opt4) from DENV-1__FJ410183__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatgtacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgagatggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatcatcctgaccgtggccgccaacgagatgggcctgctggagaccaccaagaaggacctgggcatcggccacgtggccgccgagagccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16121 - RNA, 9879 nt, synthetic construct
  misc_feature 1..9879: note = derived and/or modified CDS sequence (opt4) from DENV-1__FJ410184__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagagagaggagaacctggtgaagagcatggtgagcgccggcctgggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcgcctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggcagcctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16122 - RNA, 9879 nt, synthetic construct
  misc_feature 1..9879: note = derived and/or modified CDS sequence (opt4) from DENV-1__FJ410185__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagaggagaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16123 - RNA, 9879 nt, synthetic construct
  misc_feature 1..9879: note = derived and/or modified CDS sequence (opt4) from DENV-1__FJ547087__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcatggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcgccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggacggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccatcagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgccctgcgagctggagacccccaacctggccgagagagtgctggactggctggagaagcacggcgccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16124 - RNA, 9879 nt, synthetic construct
  misc_feature 1..9879: note = derived and/or modified CDS sequence (opt4) from DENV-1__FJ410186__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcatcgtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcgccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccaccagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcctgtggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccagagccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgagaagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgaccccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgatcagcatgaagagattcaagaacgagagcgaccccgagggcgccctgtggtga

SEQ ID NO: 16125 - RNA, 9879 nt, synthetic construct
  misc_feature 1..9879: note = derived and/or modified CDS sequence (opt4) from DENV-1__FJ410187__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacagcaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16126 - RNA, 9879 nt, synthetic construct
  misc_feature 1..9879: note = derived and/or modified CDS sequence (opt4) from DENV-1__FJ478457__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagcacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcatgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccagcggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgcagcgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtgatcgtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatgctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccaggtgatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagaagttctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgagtggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16127 - RNA, 9879 nt, synthetic construct
  misc_feature 1..9879: note = derived and/or modified CDS sequence (opt4) from DENV-1__FJ410188__SS-prME
  source 1..9879: mol_type = other RNA
agcgtgaccatgctgctgatgctgctgcccaccgtgctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagcacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcatgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccagcggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgcagcgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtgatcgtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatgctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccaggtgatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagaagttctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccatcgacgacagattcgccaccgccctgatcgccctgaacgacatgggcaaggtgagaaaggacatcccccagtgggagcccagcaagggctggaacgagtggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16128 - RNA, 9879 nt, synthetic construct
  misc_feature 1..9879: note = derived and/or modified CDS sequence (opt4) from DENV-1__FJ478458__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccatcctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgccagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16129 - RNA, 9879 nt, synthetic construct
  misc_feature 1..9879: note = derived and/or modified CDS sequence (opt4) from DENV-1__FJ410190__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagaggagaagatcgtgggcctgtacggcaacggcgtggtgaccaccagcggcacctacgtgagcgccatcgcccaggccaagaccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccagcagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16130 - RNA, 9879 nt, synthetic construct
  misc_feature 1..9879: note = derived and/or modified CDS sequence (opt4) from DENV-1__EU482591__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacagcatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagagaatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16131 - RNA, 9879 nt, synthetic construct
  misc_feature 1..9879: note = derived and/or modified CDS sequence (opt4) from DENV-1__EU482592__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcatcaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacagcaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcgcccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcgccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacagatacagctggaagagctggggcaaggccaagatcatcggcgccgacatccagaacagcaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggagaaccatggccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggaggaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccagaaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccaacgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccagcaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgtacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatgacccacagaaagcccacctacgagagagacgtggacctgggcgccggcaccagacacgtggccgtggagcccgaggtggccaacctggacatcatcggccagagaatcgagaacatcaagaacgagcacaagagcacctggtactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcttcagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctgaactggctggagaagcacggcaccgagagactgaagagaatggccatcagcggcgacgactgcgtggtgaagcccgtggacgacagattcgccaccgccctgatcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16132 - RNA, 9879 nt, synthetic construct
  misc_feature 1..9879: note = derived and/or modified CDS sequence (opt4) from DENV-1__EU482609__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccagagccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16133 - RNA, 9879 nt, synthetic construct
  misc_feature 1..9879: note = derived and/or modified CDS sequence (opt4) from DENV-1__EU482610__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggtgctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16134 - RNA, 9879 nt, synthetic construct
  misc_feature 1..9879: note = derived and/or modified CDS sequence (opt4) from DENV-1__EU482611__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16135 - RNA, 9879 nt, synthetic construct
  misc_feature 1..9879: note = derived and/or modified CDS sequence (opt4) from DENV-1__FJ639735__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcgtgatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16136 - RNA, 9879 nt, synthetic construct
  misc_feature 1..9879: note = derived and/or modified CDS sequence (opt4) from DENV-1__FJ639740__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcgccacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggaggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16137 - RNA, 9879 nt, synthetic construct
  misc_feature 1..9879: note = derived and/or modified CDS sequence (opt4) from DENV-1__FJ639741__SS-prME
  source 1..9879: mol_type = other RNA
agcgtgaccatcctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcaccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccaaggccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggcctgggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctggaacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16138 - RNA, 9879 nt, synthetic construct
  misc_feature 1..9879: note = derived and/or modified CDS sequence (opt4) from DENV-1__FJ639743__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatggccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgagatacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaaggtgatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctggtgatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcagaaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgagccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggaggccaacctggacatcatcggccagagaatcgagaacatcagaaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16139 - RNA, 9879 nt, synthetic construct
  misc_feature 1..9879: note = derived and/or modified CDS sequence (opt4) from DENV-1__FJ639794__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgtggtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacctgggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggtgcacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctggtgatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16140 - RNA, 9879 nt, synthetic construct
  misc_feature 1..9879: note = derived and/or modified CDS sequence (opt4) from DENV-1__FJ639796__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16141 - RNA, 9879 nt, synthetic construct
  misc_feature 1..9879: note = derived and/or modified CDS sequence (opt4) from DENV-1__FJ639797__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16142 - RNA, 9879 nt, synthetic construct
  misc_feature 1..9879: note = derived and/or modified CDS sequence (opt4) from DENV-1__FJ639802__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacagattccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16143 - RNA, 9879 nt, synthetic construct
  misc_feature 1..9879: note = derived and/or modified CDS sequence (opt4) from DENV-1__JN819410__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcaacctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16144 - RNA, 9879 nt, synthetic construct
  misc_feature 1..9879: note = derived and/or modified CDS sequence (opt4) from DENV-1__FJ639806__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcagagcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctgaagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16145 - RNA, 9879 nt, synthetic construct
  misc_feature 1..9879: note = derived and/or modified CDS sequence (opt4) from DENV-1__JN819411__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccgtgcccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagctgacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16146 - RNA, 9879 nt, synthetic construct
  misc_feature 1..9879: note = derived and/or modified CDS sequence (opt4) from DENV-1__FJ639812__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatgatgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgctgctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16147 - RNA, 9879 nt, synthetic construct
  misc_feature 1..9879: note = derived and/or modified CDS sequence (opt4) from DENV-1__FJ639813__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgatgaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcttcagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatgcccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacagcgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16148 - RNA, 9879 nt, synthetic construct
  misc_feature 1..9879: note = derived and/or modified CDS sequence (opt4) from DENV-1__JN819412__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgctgctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16149 - RNA, 9879 nt, synthetic construct
  misc_feature 1..9879: note = derived and/or modified CDS sequence (opt4) from DENV-1__FJ810415__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcgtgatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgaactggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16150 - RNA, 9879 nt, synthetic construct
  misc_feature 1..9879: note = derived and/or modified CDS sequence (opt4) from DENV-1__FJ639814__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16151 - RNA, 9879 nt, synthetic construct
  misc_feature 1..9879: note = derived and/or modified CDS sequence (opt4) from DENV-1__FJ639815__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatgctgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16152 - RNA, 9879 nt, synthetic construct
  misc_feature 1..9879: note = derived and/or modified CDS sequence (opt4) from DENV-1__FJ639818__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacaccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggagaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacccacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16153 - RNA, 9879 nt, synthetic construct
  misc_feature 1..9879: note = derived and/or modified CDS sequence (opt4) from DENV-1__FJ639819__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacaacttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggcctgcgtgaagaaggacctgatcagctacggcggcggctggagattccagggcctgtggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16154 - RNA, 9879 nt, synthetic construct
  misc_feature 1..9879: note = derived and/or modified CDS sequence (opt4) from DENV-1__FJ639820__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggccatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16155 - RNA, 9879 nt, synthetic construct
  misc_feature 1..9879: note = derived and/or modified CDS sequence (opt4) from DENV-1__FJ639821__SS-prME
  source 1..9879: mol_type = other RNA
agcgccaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgagatacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctactacacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacaacttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacggcatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggacaaggccgccgaggtgagctgggagcaggaggccgagcacagcggcgccagccacaacatcagcgtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggcctgcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgtgaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaaccacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtgaccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16156 - RNA, 9879 nt, synthetic construct
  misc_feature 1..9879: note = derived and/or modified CDS sequence (opt4) from DENV-1__FJ639824__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctggtggccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16157 - RNA, 9879 nt, synthetic construct
  misc_feature 1..9879: note = derived and/or modified CDS sequence (opt4) from DENV-1__JN819425__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgtgaagatcagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16158 - RNA, 9879 nt, synthetic construct
  misc_feature 1..9879: note = derived and/or modified CDS sequence (opt4) from DENV-1__FJ850099__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgagcagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16159 - RNA, 9879 nt, synthetic construct
  misc_feature 1..9879: note = derived and/or modified CDS sequence (opt4) from DENV-1__FJ850100__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacccacctggccctgatggccaccttcaagatgagacccatgttcgccgtgggcctgctgttcagaagactgaccagcagagaggtgctgctgctgaccatcggcctgagcctgatggccagcatggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatgatcctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcaccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16160 - RNA, 9879 nt, synthetic construct
  misc_feature 1..9879: note = derived and/or modified CDS sequence (opt4) from DENV-1__FJ882579__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctgacccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgctgctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16161 - RNA, 9879 nt, synthetic construct
  misc_feature 1..9879: note = derived and/or modified CDS sequence (opt4) from DENV-1__JN819414__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcctacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgctgctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccggcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacaccgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16162 - RNA, 9879 nt, synthetic construct
  misc_feature 1..9879: note = derived and/or modified CDS sequence (opt4) from DENV-1__FJ873810__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16163 - RNA, 9879 nt, synthetic construct
  misc_feature 1..9879: note = derived and/or modified CDS sequence (opt4) from DENV-1__FJ850103__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagagagcatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16164 - RNA, 9879 nt, synthetic construct
  misc_feature 1..9879: note = derived and/or modified CDS sequence (opt4) from DENV-1__FJ850104__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgtgaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaaccacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggaggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16165 - RNA, 9879 nt, synthetic construct
  misc_feature 1..9879: note = derived and/or modified CDS sequence (opt4) from DENV-1__JN819405__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacccacctggccctgatggccaccttcaagatgagacccatgttcgccgtgggcctgctgttcagaagactgaccagcagagaggtgctgctgctgaccatcggcctgagcctgatggccagcatggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatgatcctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagaccaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaacttcaccgaggtgaagggctacaccagcggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgaagggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16166 - RNA, 9879 nt, synthetic construct
  misc_feature 1..9879: note = derived and/or modified CDS sequence (opt4) from DENV-1__GQ199877__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccagcagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagaagagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16167 - RNA, 9879 nt, synthetic construct
  misc_feature 1..9879: note = derived and/or modified CDS sequence (opt4) from DENV-1__GU056029__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggtgcagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccgccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16168 - RNA, 9879 nt, synthetic construct
  misc_feature 1..9879: note = derived and/or modified CDS sequence (opt4) from DENV-1__GU056030__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgagatacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctactacacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacaacttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacggcatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggacaaggccgccgaggtgagctgggagcaggaggccgagcacagcggcgccagccacaacatcagcgtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggcctgcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgtgaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaaccacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtgaccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16169 - RNA, 9879 nt, synthetic construct
  misc_feature 1..9879: note = derived and/or modified CDS sequence (opt4) from DENV-1__GU056031__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccagcaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacagcgactacatgaccagcatgaagagattcaagaacgagagcgaccccgagggcgccctgtggtga

SEQ ID NO: 16170 - RNA, 9879 nt, synthetic construct
  misc_feature 1..9879: note = derived and/or modified CDS sequence (opt4) from DENV-1__GU056032__SS-prME
  source 1..9879: mol_type = other RNA
agcgtggccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccgtgggcatcgtgagcatgctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaagatcagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacaccgagggcgccctgtggtga

SEQ ID NO: 16171 - RNA, 9879 nt, synthetic construct
  misc_feature 1..9879: note = derived and/or modified CDS sequence (opt4) from DENV-1__GU056033__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtgaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccaaggccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcagccagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagagccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagaccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggcctgggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctggaacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16172 - RNA, 9879 nt, synthetic construct
  misc_feature 1..9879: note = derived and/or modified CDS sequence (opt4) from DENV-1__GU131833__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccagaacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatcaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatggccagcatgaagagattcaagaacgagagcgaccccgagggcgccctgtggtga

SEQ ID NO: 16173 - RNA, 9879 nt, synthetic construct
  misc_feature 1..9879: note = derived and/or modified CDS sequence (opt4) from DENV-1__GU131834__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaagaccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcttcatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16174 - RNA, 9879 nt, synthetic construct
  misc_feature 1..9879: note = derived and/or modified CDS sequence (opt4) from DENV-1__GU131835__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggtgctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggccgaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatgaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgatgctgttcttcctgagcggcaagggcctgggcaagaccagcatcggcctgctgtgcgtgaccgccagcagcgccctgctgtggatggccagcgtggagccccactggatcgccgccagcatcgtgctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagcccgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccaccgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcagaatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccagcctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacctggagggcgccctgtggtga

SEQ ID NO: 16175 - RNA, 9879 nt, synthetic construct
  misc_feature 1..9879: note = derived and/or modified CDS sequence (opt4) from DENV-1__GU131836__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggtgcagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctgagcagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtgcccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccggccacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16176 - RNA, 9879 nt, synthetic construct
  misc_feature 1..9879: note = derived and/or modified CDS sequence (opt4) from DENV-1__GU131837__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggaggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcaccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16177 - RNA, 9879 nt, synthetic construct
  misc_feature 1..9879: note = derived and/or modified CDS sequence (opt4) from DENV-1__JN819415__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcaccagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcatcaagaccaccctgagcctggactacgcctggaagaccaccgccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcaccagccacaacatcctggtggaggtgcaggacgacggcaccatgaagatcaaggacgaggagaaggacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagagagacctgggcatcggccacgtggccgccgagaaccaccagcacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagtgctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16178 - RNA, 9879 nt, synthetic construct
  misc_feature 1..9879: note = derived and/or modified CDS sequence (opt4) from DENV-1__GU131838__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaagaccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16179 - RNA, 9879 nt, synthetic construct
  misc_feature 1..9879: note = derived and/or modified CDS sequence (opt4) from DENV-1__GU131839__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagaccgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggtgcagggcaagaagatgatcagaccccagcccatggagcacaagtacagctggaagagctggggcaaggccaagatcatcggcgccgacacccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccgccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacaacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccagcgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcagagagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacgtgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgacagcgagggcgccctgtggtga

SEQ ID NO: 16180 - RNA, 9879 nt, synthetic construct
  misc_feature 1..9879: note = derived and/or modified CDS sequence (opt4) from DENV-1__GU131841__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagagaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccttcttcctggcctacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcagcacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagagaggcagcagcatcggcaagatgttcgaggccaccgccagaggcgccagaagaatggccatcctgggcgacaccgcctgggacttcggcagcatcggcggcgtgttcaccagcgtgggcaagctggtgcaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacggccagagagcctggaacatctgggaggtggaggactacggcttcggcgtgttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcacctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgagttccagccccaccagctgtggaccaccctgctgagcctgaccttcgtgaagaccaccctgagcctggactacgcctggaagaccaccgccatggtgctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccctgaacgagggcatcatggccatcggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggagcaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacgtgtacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgaccgccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggctacgtggccgccgagaaccaccagcacgccaccatgctggacgtggacctgcaccccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatgccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccacccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggtgcagctgatcagacagatggagagcgagggcatcttcctgcccagcgagctggagacccccaacctggccgagagagccctggactggctggagaagcacggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16181 - RNA, 9879 nt, synthetic construct
  misc_feature 1..9879: note = derived and/or modified CDS sequence (opt4) from DENV-1__GQ868601__SS-prME
  source 1..9879: mol_type = other RNA
agcgtgaccatgctgctgatgctgctgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcaacagagacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccagactggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcaggtgaagtacgagggcaccgacgccccctgcaagatccccttcctgacccaggacgagaagggcgtgacccagaacggcagactgatcaccgccaaccccatcgtgaccgacaaggagaagcccgtgaacatcgagaccgagccccccttcggcgagagctacatcgtggtgggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcctgttcaccagcgtgggcaagctgatccaccaggtgttcggcaccgcctacggcgtgctgttcagcggcgtgagctggaccatgaagatcggcatcggcatcctgctgacctggctgggcctgaacagcagaagcaccagcctgagcatgacctgcatcgccgtgggcatggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaactacatcctgctggagaacgacatgaagttcaccgtggtggtgggcgacgccaacggcatcctggcccagggcaagaagatgatcagaccccagcccatggagcacaagtacagctggaagagctggggcaaggccaagatcatcggcgccgacatccagaacaccaccttcatcatcgacggccccgacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggctacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgagaagcatggtgagcgccggcagcggcgaggtggacagcttcagcctgggcatcctgtgcgtgagcatcctgatcgaggaggtgatgagaagcagatggagcagaagaatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatgctgaagctgctgaccgacttccagccccaccagctgtggaccaccctgctgagcctgaccttcatcagaaccaccctgagcctggactacgcctggaagaccatggccatggccctgagcatcgtgagcctgttccccctgtgcctgagcaccaccagccagaagaccacctggctgcccgtgctgctgggcagcttcggctgcaagcccctgaccatgttcctgatcaccgagaacaagatctggggcagaaagagctggcccatcaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccatgagcatccccgccaccctgttcgtgtggtacttctggcagaagaagaagcagagaagcggcgtgctgtgggacacccccagcccccccgaggtggagagagccgtgctggacgacggcatctacagaatcctgcagagaggcctgctgggcagaagccaggtgggcgtgggcgtgttccaggacggcgtgttccacaccatgtggcacgtgaccagaggcgccgtgctgatgtaccagggcaagagactggagcccagctgggccagcgtgaagaaggacctgatcagctacggcggcggctggagattccagggcagctggaacaccggcgaggaggtgcaggtgatcgccgtggagcccggcaagaaccccaagaacgtgcagaccacccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcaagaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccgccagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgactggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccagaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgaccctgagagcccagaacgccctggacaacctggtgatgctgcacaacagcgagcagggcggcaaggcctacagacacgccatggaggagctgcccgacaccatcgagaccctgatgctgctggccctgatcgccgtgctgaccggcggcgtgaccctgttcttcctgagcggcaagggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgccgagaaccaccaccacgccaccatgctggacgtggacctgagacccgccagcgcctggaccctgtacgccgtggccaccaccgtgatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtgaccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagaacgagcacaagagcacctggcactacgacgaggacaacccctacaagacctgggcctaccacggcagctacgaggtgaagcccagcggcagcgccagcagcatggtgaacggcgtggtgagactgctgaccaagccctgggacgtgatccccatggtgacccagatcgccatgaccgacaccacccccttcggccagcagagagtgttcaaggagaaggtggacaccagaacccccagagccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagagcggcaccgtgatggacgtgatcagcagaagagaccagagaggcagcggccaggtgggcacctacggcctgaacaccttcaccaacatggaggtgcagctgatcagacagatggagagcgagggcatcttcagccccagcgagctggagacccccaacctggccaagagagtgctggactggctggagaagcagggcgccgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctgggaggaggtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16182 - RNA, 9879 nt, synthetic construct
  misc_feature 1..9879: note = derived and/or modified CDS sequence (opt4) from DENV-1__EU660390__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtgatcgtgggcgacgtggccggcatcctgggccagggcagaaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctggtggccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16183 - RNA, 9879 nt, synthetic construct
  misc_feature 1..9879: note = derived and/or modified CDS sequence (opt4) from DENV-1__EU660391__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggacggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagtacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16184 - RNA, 9879 nt, synthetic construct
  misc_feature 1..9879: note = derived and/or modified CDS sequence (opt4) from DENV-1__EU660393__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcatcacccagagcggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacagaagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16185 - RNA, 9879 nt, synthetic construct
  misc_feature 1..9879: note = derived and/or modified CDS sequence (opt4) from DENV-1__EU660401__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16186 - RNA, 9879 nt, synthetic construct
  misc_feature 1..9879: note = derived and/or modified CDS sequence (opt4) from DENV-1__FJ373305__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccgtgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16187 - RNA, 9879 nt, synthetic construct
  misc_feature 1..9879: note = derived and/or modified CDS sequence (opt4) from DENV-1__EU660402__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcatcgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagatctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgcctacgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagccacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgatgctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16188 - RNA, 9879 nt, synthetic construct
  misc_feature 1..9879: note = derived and/or modified CDS sequence (opt4) from DENV-1__EU660403__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16189 - RNA, 9879 nt, synthetic construct
  misc_feature 1..9879: note = derived and/or modified CDS sequence (opt4) from DENV-1__EU660397__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16190 - RNA, 9879 nt, synthetic construct
  misc_feature 1..9879: note = derived and/or modified CDS sequence (opt4) from DENV-1__EU687247__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctggcccagggcaagaagatgatcagaccccagcccatggagtacaagtacagctggaagatctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcagaaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaagactgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctgaactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccaccaacatccaggtggccatcaaccaggtgagaagactgctgggcaacgagaactacctggactacatgaccagcatgaagagattcaagaacgagagcgaccccgagggcgccctgtggtga

SEQ ID NO: 16191 - RNA, 9879 nt, synthetic construct
  misc_feature 1..9879: note = derived and/or modified CDS sequence (opt4) from DENV-1__EU660412__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgatcagcatgaagagattcaagaacgagagcgaccccgagggcgccctgtggtga

SEQ ID NO: 16192 - RNA, 9879 nt, synthetic construct
  misc_feature 1..9879: note = derived and/or modified CDS sequence (opt4) from DENV-1__EU660418__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggcacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16193 - RNA, 9879 nt, synthetic construct
  misc_feature 1..9879: note = derived and/or modified CDS sequence (opt4) from DENV-1__EU677151__SS-prME
  source 1..9879: mol_type = other RNA
agcgtgaccatgctgctgatgctgatccccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggcgccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatggtggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16194 - RNA, 9879 nt, synthetic construct
  misc_feature 1..9879: note = derived and/or modified CDS sequence (opt4) from DENV-1__EU677152__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgccgccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16195 - RNA, 9879 nt, synthetic construct
  misc_feature 1..9879: note = derived and/or modified CDS sequence (opt4) from DENV-1__EU677155__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcaccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccggcagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16196 - RNA, 9879 nt, synthetic construct
  misc_feature 1..9879: note = derived and/or modified CDS sequence (opt4) from DENV-1__EU677157__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccctggtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccaagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16197 - RNA, 9879 nt, synthetic construct
  misc_feature 1..9879: note = derived and/or modified CDS sequence (opt4) from DENV-1__EU677158__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggagcagaaagatgctgatgaccggcaccctggccgtgttcgtgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16198 - RNA, 9879 nt, synthetic construct
  misc_feature 1..9879: note = derived and/or modified CDS sequence (opt4) from DENV-1__EU677159__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccatcagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctgggcaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgatcagcatgaagagattcaagaacgagagcgaccccgagggcgccctgtggtga

SEQ ID NO: 16199 - RNA, 9879 nt, synthetic construct
  misc_feature 1..9879: note = derived and/or modified CDS sequence (opt4) from DENV-1__EU677160__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctggtgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcctggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccagaagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16200 - RNA, 9879 nt, synthetic construct
  misc_feature 1..9879: note = derived and/or modified CDS sequence (opt4) from DENV-1__EU677162__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcagaatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16201 - RNA, 9879 nt, synthetic construct
  misc_feature 1..9879: note = derived and/or modified CDS sequence (opt4) from DENV-1__EU677164__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatcgccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagaactacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgctgttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccaccctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16202 - RNA, 9879 nt, synthetic construct
  misc_feature 1..9879: note = derived and/or modified CDS sequence (opt4) from DENV-1__EU677165__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatcacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggccacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctggccagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16203 - RNA, 9879 nt, synthetic construct
  misc_feature 1..9879: note = derived and/or modified CDS sequence (opt4) from DENV-1__EU677140__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgaagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16204 - RNA, 9879 nt, synthetic construct
  misc_feature 1..9879: note = derived and/or modified CDS sequence (opt4) from DENV-1__EU677166__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtgaactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16205 - RNA, 9879 nt, synthetic construct
  misc_feature 1..9879: note = derived and/or modified CDS sequence (opt4) from DENV-1__EU677170__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggatgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccatcctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16206 - RNA, 9879 nt, synthetic construct
  misc_feature 1..9879: note = derived and/or modified CDS sequence (opt4) from DENV-1__EU677171__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16207 - RNA, 9879 nt, synthetic construct
  misc_feature 1..9879: note = derived and/or modified CDS sequence (opt4) from DENV-1__EU677172__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgaccatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16208 - RNA, 9879 nt, synthetic construct
  misc_feature 1..9879: note = derived and/or modified CDS sequence (opt4) from DENV-1__EU677173__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccaccaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccagatgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcaccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacgccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagtacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16209 - RNA, 9879 nt, synthetic construct
  misc_feature 1..9879: note = derived and/or modified CDS sequence (opt4) from DENV-1__EU726779__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16210 - RNA, 9879 nt, synthetic construct
  misc_feature 1..9879: note = derived and/or modified CDS sequence (opt4) from DENV-1__EU677176__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcctgttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccaagagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagagaatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgacagcgaccccgagggcgccctgtggtga

SEQ ID NO: 16211 - RNA, 9879 nt, synthetic construct
  misc_feature 1..9879: note = derived and/or modified CDS sequence (opt4) from DENV-1__EU726780__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaagaccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggtgaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcagcgagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcatcgagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16212 - RNA, 9879 nt, synthetic construct
  misc_feature 1..9879: note = derived and/or modified CDS sequence (opt4) from DENV-1__EU726781__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagaccgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgtggtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagaactacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgctgttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16213 - RNA, 9879 nt, synthetic construct
  misc_feature 1..9879: note = derived and/or modified CDS sequence (opt4) from DENV-1__EU726782__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16214 - RNA, 9879 nt, synthetic construct
  misc_feature 1..9879: note = derived and/or modified CDS sequence (opt4) from DENV-1__EU677178__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacaccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgagatcgccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16215 - RNA, 9879 nt, synthetic construct
  misc_feature 1..9879: note = derived and/or modified CDS sequence (opt4) from DENV-1__EU687251__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgaagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16216 - RNA, 9879 nt, synthetic construct
  misc_feature 1..9879: note = derived and/or modified CDS sequence (opt4) from DENV-1__FJ024427__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccggctacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcgccgacgccccctgcaagatccccttcagcacccaggacgagaagggcatcacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcaacagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16217 - RNA, 9879 nt, synthetic construct
  misc_feature 1..9879: note = derived and/or modified CDS sequence (opt4) from DENV-1__FJ024428__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16218 - RNA, 9879 nt, synthetic construct
  misc_feature 1..9879: note = derived and/or modified CDS sequence (opt4) from DENV-1__FJ024429__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgatgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagatcgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagagaaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16219 - RNA, 9879 nt, synthetic construct
  misc_feature 1..9879: note = derived and/or modified CDS sequence (opt4) from DENV-1__FJ024430__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgctgctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgccctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccaccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccgtggacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16220 - RNA, 9879 nt, synthetic construct
  misc_feature 1..9879: note = derived and/or modified CDS sequence (opt4) from DENV-1__FJ024433__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcatcagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggaacctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16221 - RNA, 9879 nt, synthetic construct
  misc_feature 1..9879: note = derived and/or modified CDS sequence (opt4) from DENV-1__FJ024434__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagtacaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccgccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggaggccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgatcagcatgaagagattcaagaacgagagcgaccccgagggcgccctgtggtga

SEQ ID NO: 16222 - RNA, 9879 nt, synthetic construct
  misc_feature 1..9879: note = derived and/or modified CDS sequence (opt4) from DENV-1__FJ024435__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgaccgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatctacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16223 - RNA, 9879 nt, synthetic construct
  misc_feature 1..9879: note = derived and/or modified CDS sequence (opt4) from DENV-1__FJ024436__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagtacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggacgagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgctggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccacctacagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgagaacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaaagagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16224 - RNA, 9879 nt, synthetic construct
  misc_feature 1..9879: note = derived and/or modified CDS sequence (opt4) from DENV-1__FJ024472__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccgtgggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgatcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16225 - RNA, 9879 nt, synthetic construct
  misc_feature 1..9879: note = derived and/or modified CDS sequence (opt4) from DENV-1__FJ024439__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcttcagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacaggccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16226 - RNA, 9879 nt, synthetic construct
  misc_feature 1..9879: note = derived and/or modified CDS sequence (opt4) from DENV-1__FJ024441__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggagacagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcaccatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcgtgtggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16227 - RNA, 9879 nt, synthetic construct
  misc_feature 1..9879: note = derived and/or modified CDS sequence (opt4) from DENV-1__FJ024442__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcagaatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacctgggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16228 - RNA, 9879 nt, synthetic construct
  misc_feature 1..9879: note = derived and/or modified CDS sequence (opt4) from DENV-1__FJ373296__SS-prME
  source 1..9879: mol_type = other RNA
agcgtgaccatgctgctgatgctgatgcccatcgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgccacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagctgaccgtggtggtgggcgacgtggccggcatcctgggccagggcaagaagatgatcagaccccagcccatggagtacaagtacagctggaagagctggggcaaggccaagatcatcggcgccgacgcccagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgagaggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccgtggacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcaccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaaggccatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagccctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctgggaggacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16229 - RNA, 9879 nt, synthetic construct
  misc_feature 1..9879: note = derived and/or modified CDS sequence (opt4) from DENV-1__FJ182018__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccatcatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16230 - RNA, 9879 nt, synthetic construct
  misc_feature 1..9879: note = derived and/or modified CDS sequence (opt4) from DENV-1__FJ410287__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccagccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16231 - RNA, 9879 nt, synthetic construct
  misc_feature 1..9879: note = derived and/or modified CDS sequence (opt4) from DENV-1__FJ432719__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccgccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16232 - RNA, 9879 nt, synthetic construct
  misc_feature 1..9879: note = derived and/or modified CDS sequence (opt4) from DENV-1__FJ182020__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagttctgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagaaaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16233 - RNA, 9879 nt, synthetic construct
  misc_feature 1..9879: note = derived and/or modified CDS sequence (opt4) from DENV-1__FJ182022__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16234 - RNA, 9879 nt, synthetic construct
  misc_feature 1..9879: note = derived and/or modified CDS sequence (opt4) from DENV-1__FJ024447__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaaggtggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16235 - RNA, 9879 nt, synthetic construct
  misc_feature 1..9879: note = derived and/or modified CDS sequence (opt4) from DENV-1__FJ182025__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtgggcagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatcgccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaacatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccaccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccgtggacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16236 - RNA, 9879 nt, synthetic construct
  misc_feature 1..9879: note = derived and/or modified CDS sequence (opt4) from DENV-1__FJ373297__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcctgttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagcacggcgtggagagactgaagagaatggccatcagcggcgacgactgcgtggtgaagcccatcgacgacagattcgccaccgccctgagcgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccaacagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgacagcgaccccgagggcgccctgtggtga

SEQ ID NO: 16237 - RNA, 9879 nt, synthetic construct
  misc_feature 1..9879: note = derived and/or modified CDS sequence (opt4) from DENV-1__FJ024448__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatcacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgccagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16238 - RNA, 9879 nt, synthetic construct
  misc_feature 1..9879: note = derived and/or modified CDS sequence (opt4) from DENV-1__FJ182026__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccagaacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacgccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16239 - RNA, 9879 nt, synthetic construct
  misc_feature 1..9879: note = derived and/or modified CDS sequence (opt4) from DENV-1__FJ182027__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatcacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgagaggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16240 - RNA, 9879 nt, synthetic construct
  misc_feature 1..9879: note = derived and/or modified CDS sequence (opt4) from DENV-1__FJ024449__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagccacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgacgtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctgaagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16241 - RNA, 9879 nt, synthetic construct
  misc_feature 1..9879: note = derived and/or modified CDS sequence (opt4) from DENV-1__FJ390383__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcctgacccaggacgagaagggcgtgacccagaacggcagactgatcaccgccaaccccatcgtgaccgacaaggagaagcccgtgaacatcgaggccgagccccccttcggcgagagctacatcatcatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatcatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgagcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagatccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagggcgaccccgagggcgccctgtggtga

SEQ ID NO: 16242 - RNA, 9879 nt, synthetic construct
  misc_feature 1..9879: note = derived and/or modified CDS sequence (opt4) from DENV-1__FJ182033__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggtggagcccgacgacgtggactgctggtgcaacaccaccgacacctgggtgacctacggcacctgcagccagaccggcgagcacagaagagacaagagaagcgtggccctggccccccacgtgggcctgggcctggagaccagagccgagacctggatgagcagcgagggcgcctggaagcagatccagaaggtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcatcggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggagacagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagaagctgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagctaccagctgtgggccaccctgctgagcctgaccttcatcaagaccaccttcagcctgcactacgcctggaagaccatggccatggtgctgagcatcgtgagcctgctgcccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcagagagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgccctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgagaagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggcctgggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccagaaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16243 - RNA, 9879 nt, synthetic construct
  misc_feature 1..9879: note = derived and/or modified CDS sequence (opt4) from DENV-1__FJ182034__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcatgacctacctggccctgatggccaccttcaagatgagacccatgctggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccacctacagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgagaacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16244 - RNA, 9879 nt, synthetic construct
  misc_feature 1..9879: note = derived and/or modified CDS sequence (opt4) from DENV-1__FJ182036__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggccacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatgagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccaagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16245 - RNA, 9879 nt, synthetic construct
  misc_feature 1..9879: note = derived and/or modified CDS sequence (opt4) from DENV-1__FJ205876__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcaacagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16246 - RNA, 9879 nt, synthetic construct
  misc_feature 1..9879: note = derived and/or modified CDS sequence (opt4) from DENV-1__FJ024455__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgtgggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccccccccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16247 - RNA, 9879 nt, synthetic construct
  misc_feature 1..9879: note = derived and/or modified CDS sequence (opt4) from DENV-1__FJ024456__SS-prME
  source 1..9879: mol_type = other RNA
agcgtgaccatgctgctgatgctgatgcccaccgccctggccttccacctgaccaccagaggcggcgagccccacatgatcgtgaccaagcaggagagaggcaagagcctgctgttcaagaccagcgccggcgtgaacatgtgcatcctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctgatggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccagcgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgatccagaacggcagactgatcaccgccaaccccatcgtgaccgacaaggagaagcccgtgaacatcgaggccgagccccccttcggcgagagctacatcgtgatcggcgtgggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggtgggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggcctgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatggtgatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcctgctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccctgagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcgtggtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccaccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacatctacaagagaagcggcatcatggaggtggacagaagcgaggccaaggagggcctgaagagaggcgagaccaccagacacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggcatggaggagcccatccccatggccaccaacggctggaacctggtgaagctgcacagcggcaaggacgtgttcttcaccccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccagatggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcagaaggagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaccagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcctgcccagcgagctggagacccccaacctggccgagagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacgtgagcagctggggcgacgtgccctacctgggcaagagagaggaccagtggtgcggcagcctgatcggcctgaccgccagagccacctgggccagcaacatccaggtggccatcaaccaggtgagaagactgatcggcaacgagaactacctggactacatgaccagcatgaagagattcaagaacgagggcgaccccgagggcgccctgtggtga

SEQ ID NO: 16248 - RNA, 9879 nt, synthetic construct
  misc_feature 1..9879: note = derived and/or modified CDS sequence (opt4) from DENV-1__FJ024457__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccagaagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccatcctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16249 - RNA, 9879 nt, synthetic construct
  misc_feature 1..9879: note = derived and/or modified CDS sequence (opt4) from DENV-1__FJ205881__SS-prME
  source 1..9879: mol_type = other RNA
agcgtgaccatgctgctgctgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaagaccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16250 - RNA, 9879 nt, synthetic construct
  misc_feature 1..9879: note = derived and/or modified CDS sequence (opt4) from DENV-1__FJ205882__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccagcaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggacgagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctggaaggtggaggaccacggcttcggcatcttccccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcaacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcaagggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgctggccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccacctacagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaaagagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagaccagcgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgagaacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaaagagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccaagatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccggcagagtgctggactggctggagaagcacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactgggtgcccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16251 - RNA, 9879 nt, synthetic construct
  misc_feature 1..9879: note = derived and/or modified CDS sequence (opt4) from DENV-1__FJ390388__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgatgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagcacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatcagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcgtgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcgtggtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagagaaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccgagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga

SEQ ID NO: 16252 - RNA, 9879 nt, synthetic construct
  misc_feature 1..9879: note = derived and/or modified CDS sequence (opt4) from DENV-1__FJ024464__SS-prME
  source 1..9879: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgagaccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggagctggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgtgagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggccgacagcggctgcgtgatcaactggaagggcagagagctgaagtgcggcagcggcatcttcgtgaccaacgaggtgcacacctggaccgagcagtacaagttccaggccgacagccccaagagactgagcgccgccatcggcaaggcctgggaggagggcgtgtgcggcatcagaagcgccaccagactggagaacatcatgtggaagcagatcagcaacgagctgaaccacatcctgctggagaacgacatgaagttcaccgtggtggtgggcgacgtggccggcatcctggcccagggcaagaagatgatcagaccccagcccatggagtacaagtacagctggaagagctggggcaaggccaagatcatcggcgccgacgtgcagaacaccaccttcatcatcgacggccccaacacccccgagtgccccgacgaccagagagcctggaacatctgggaggtggaggactacggcttcggcatcttcaccaccaacatctggctgaagctgagagacagctacacccaggtgtgcgaccacagactgatgagcgccgccatcaaggacagcaaggccgtgcacgccgacatgggctactggatcgagagcgagaagaacgagacctggaagctggccagagccagcttcatcgaggtgaagacctgcatctggcccaagagccacaccctgtggagcaacggcgtgctggagagcgagatgatcatccccaagatctacggcggccccatgagccagcacaactacagacccggctacttcacccagaccgccggcccctggcacctgggcaagctggagctggacttcgacctgtgcgagggcaccaccgtggtggtggacgagcactgcggcaacagaggccccagcctgagaaccaccaccgtgaccggcaagatcatccacgagtggtgctgcagaagctgcaccctgccccccctgagattcagaggcgaggacggctgctggtacggcatggagatcagacccgtgaaggagaaggaggagaacctggtgaagagcatggtgagcgccggcagcggcgaggtggacagcttcagcctgggcctgctgtgcatcagcatcatgatcgaggaggtgatgagaagcagatggagcagaaagatgctgatgaccggcaccctggccgtgttcttcctgctgatcatgggccagctgacctggaacgacctgatcagactgtgcatcatggtgggcgccaacgccagcgacagaatgggcatgggcaccacctacctggccctgatggccaccttcaagatgagacccatgttcgccgtgggcctgctgttcagaagactgaccagcagagaggtgctgctgctgaccatcggcctgagcctggtggccagcgtggagctgcccaacagcctggaggagctgggcgacggcctggccatgggcatcatgatcctgaagctgctgaccgacttccagagccaccagctgtgggccaccctgctgagcctgaccttcatcaagaccaccttcagcctgcactacgcctggaagaccatggccatggtgctgagcatcgtgagcctgttccccctgtgcctgagcaccaccagccagaagaccacctggctgcccgtgctgctgggcagcctgggctgcaagcccctgaccatgttcctgatcgccgagaacaagatctggggcagaagaagctggcccctgaacgagggcatcatggccgtgggcatcgtgagcatcctgctgagcagcctgctgaagaacgacgtgcccctggccggccccctgatcgccggcggcatgctgatcgcctgctacgtgatcagcggcagcagcgccgacctgagcctggagaaggccgccgaggtgagctgggaggaggaggccgagcacagcggcgccagccacaacatcctggtggaggtgcaggacgacggcaccatgaagatcaaggacgaggagagagacgacaccctgaccatcctgctgaaggccaccctgctggccgtgagcggcgtgtaccccctgagcatccccgccaccctgttcgtgtggtacttctggcagaagaagaagcagagaagcggcgtgctgtgggacacccccagcccccccgaggtggagagagccgtgctggacgacggcatctacagaatcatgcagagaggcctgctgggcagaagccaggtgggcgtgggcgtgttccaggagaacgtgttccacaccatgtggcacgtgaccagaggcgccgtgctgatgtaccagggcaagagactggagcccagctgggccagcgtgaagaaggacctgatcagctacggcggcggctggagactgcagggcagctggaacaccggcgaggaggtgcaggtgatcgccgtggagcccggcaagaaccccaagaacgtgcagaccgcccccggcaccttcaagacccccgagggcgaggtgggcgccatcgccctggacttcaagcccggcaccagcggcagccccatcgtgaacagagagggcaagatcgtgggcctgtacggcaacggcgtggtgaccaccagcggcacctacgtgagcgccatcgcccaggccaaggccagccaggagggccccctgcccgagatcgaggacgaggtgttcagaaagagaaacctgaccatcatggacctgcaccccggcagcggcaagaccagaagatacctgcccgccatcgtgagagaggccatcaagagaaagctgagaaccctgatcctggcccccaccagagtggtggccagcgagatggccgaggccctgaagggcatgcccatcagataccagaccaccgccgtgaagagcgagcacaccggcaaggagatcgtggacctgatgtgccacgccaccttcaccatgagactgctgagccccgtgagagtgcccaactacaacatgatcatcatggacgaggcccacttcaccgaccccagcagcatcgccgccagaggctacatcagcaccagagtgggcatgggcgaggccgccgccatcttcatgaccgccaccccccccggcagcgtggaggccttcccccagagcaacgccgtgatccaggacgaggagagagacatccccgagagaagctggaacagcggctacgagtggatcaccgacttccccggcaagaccgtgtggttcgtgcccagcatcaagagcggcaacgacatcgccaactgcctgagaaagaacggcaagagagtgatccagctgagcagaaagaccttcgacaccgagtaccagaagaccaagaacaacgactgggactacgtggtgaccaccgacatcagcgagatgggcgccaacttcagagccgacagagtgatcgaccccagaagatgcctgaagcccgtgatcctgaaggacggccccgagagagtgatcctggccggccccatgcccgtgaccgtggccagcgccgcccagagaagaggcagaatcggcagaaaccacaacaaggagggcgaccagtacatctacatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgagaggcgaggccagaaagaccttcgtggagctgatgagaagaggcgacctgcccgtgtggctgagctacaaggtggccagcgagggcttccagtacagcgacagaagatggtgcttcgacggcgagagaaacaaccaggtgctggaggagaacatggacgtggagatctggaccaaggagggcgagagaaagaagctgagacccagatggctggacgccagaacctacagcgaccccctggccctgagagagttcaaggagttcgccgccggcagaagaagcgtgagcggcgacctgatcctggagatcggcaagctgccccagcacctgacccagagagcccagaacgccctggacaacctggtgatgctgcacaacagcgagcagggcggcagagcctacagacacgccatggaggagctgcccgacaccatcgagaccctgatgctgctggccctgatcgccgtgctgaccggcggcgtgaccctgttcttcctgagcggcagaggcctgggcaagaccagcatcggcctgctgtgcgtgatggccagcagcgtgctgctgtggatggccagcgtggagccccactggatcgccgccagcatcatcctggagttcttcctgatggtgctgctgatccccgagcccgacagacagagaaccccccaggacaaccagctggcctacgtggtgatcggcctgctgttcatgatcctgaccgtggccgccaacgagatgggcctgctggagaccaccaagaaggacctgggcatcggccacgtggccgtggagaaccaccaccacgccgccatgctggacgtggacctgcaccccgccagcgcctggaccctgtacgccgtggccaccaccatcatcacccccatgatgagacacaccatcgagaacaccaccgccaacatcagcctgaccgccatcgccaaccaggccgccatcctgatgggcctggacaagggctggcccatcagcaagatggacatcggcgtgcccctgctggccctgggctgctacagccaggtgaaccccctgaccctgaccgccgccgtgctgatgctggtggcccactacgccatcatcggccccggcctgcaggccaaggccaccagagaggcccagaagagaaccgccgccggcatcatgaagaaccccaccgtggacggcatcgtggccatcgacctggaccccgtggtgtacgacgccaagttcgagaagcagctgggccagatcatgctgctgatcctgtgcaccagccagatcctgctgatgagaaccacctgggccctgtgcgagagcatcaccctggccaccggccccctgaccaccctgtgggagggcagccccggcaagttctggaacaccaccatcgccgtgagcatggccaacatcttcagaggcagctacctggccggcgccggcctggccttcagcctgatgaagagcctgggcggcggcagaagaggcaccggcgcccagggcgagaccctgggcgagaagtggaagagacagctgaaccagctgagcaagagcgagttcaacacctacaagagaagcggcatcatggaggtggacagaagcgaggccaaggagggcctgaagagaggcgagaccaccaagcacgccgtgagcagaggcaccgccaagctgagatggttcgtggagagaaacctggtgaagcccgagggcaaggtgatcgacctgggctgcggcagaggcggctggagctactactgcgccggcctgaagaaggtgaccgaggtgaagggctacaccaagggcggccccggccacgaggagcccatccccatggccacctacggctggaacctggtgaagctgcacagcggcaaggacgtgttcttcatcccccccgagaagtgcgacaccctgctgtgcgacatcggcgagagcagccccaaccccaccatcgaggagggcagaaccctgagagtgctgaagatggtggagccctggctgagaggcaaccagttctgcatcaagatcctgaacccctacatgcccagcgtggtggagaccctggagcagatgcagagaaagcacggcggcatgctggtgagaaaccccctgagcagaaacagcacccacgagatgtactgggtgagctgcggcaccggcaacatcgtgagcgccgtgaacatgaccagcagaatgctgctgaacagattcaccatggcccacagaaagcccacctacgagagagacgtggacctgggcgccggcaccagacacgtggccgtggagcccgaggtggccaacctggacatcatcggccagagaatcgagaacatcaagcacgagcacaagagcacctggcactacgacgaggacaacccctacaagacctgggcctaccacggcagctacgaggtgaagcccagcggcagcgccagcagcatggtgaacggcgtggtgaagctgctgaccaagccctgggacgtgatccccatggtgacccagatcgccatgaccgacaccacccccttcggccagcagagagtgttcaaggagaaggtggacaccagaacccccaaggccaagagaggcaccgcccagatcatggaggtgaccgccaagtggctgtggggcttcctgagcagaaacaagaagcccagaatctgcaccagagaggagttcaccagaaaggtgagaagcaacgccgccatcggcgccgtgttcgtggacgagaaccagtggaacagcgccaaggaggccgtggaggacgagagattctgggacctggtgcacagagagagagagctgcacaagcagggcaagtgcgccacctgcgtgtacaacatgatgggcaagagagagaagaagctgggcgagttcggcaaggccaagggcagcagagccatctggtacatgtggctgggcgccagattcctggagttcgaggccctgggcttcatgaacgaggaccactggttcagcagagagaacagcctgagcggcgtggagggcgagggcctgcacaagctgggctacatcctgagagacatcagcaagatccccggcggcaacatgtacgccgacgacaccgccggctgggacaccagaatcaccgaggacgacctgcagaacgaggccagaatcaccgacatcatggagcccgagcacgccctgctggccaagagcatcttcaagctgacctaccagaacaaggtggtgagagtgcagagacccgccaagaacggcaccgtgatggacgtgatcagcagaagagaccagagaggcagcggccaggtgggcacctacggcctgaacaccttcaccaacatggaggcccagctgatcagacagatggagagcgagggcatcttcagccccagcgagctggagacccccaacctggccaagagagtgctggactggctggagaagtacggcgtggagagactgaagagaatggccatcagcggcgacgactgcgtggtgaagcccatcgacgacagattcgccaccgccctgaccgccctgaacgacatgggcaaggtgagaaaggacatcccccagtgggagcccagcaagggctggaacgactggcagcaggtgcccttctgcagccaccacttccaccagctgatcatgaaggacggcagagagatcgtggtgccctgcagaaaccaggacgagctggtgggcagagccagagtgagccagggcgccggctggagcctgagagagaccgcctgcctgggcaagagctacgcccagatgtggcagctgatgtacttccacagaagagacctgagactggccgccaacgccatctgcagcgccgtgcccgtggactggatccccaccagcagaaccacctggagcatccacgcccaccaccagtggatgaccaccgaggacatgctgagcgtgtggaacagagtgtggatcgaggagaacccctggatggaggacaagacccacatcagcagctggggcgacgtgccctacctgggcaagagagaggaccagtggtgcggcagcctgatcggcctgaccgccagagccacctgggccaccaacatccaggtggccatcaaccaggtgagaagactgatcggcaacgagaactacctggactacatgaccagcatgaagagattcaagaacgagagcgaccccgagggcgccctgtggtga
